United States Patent 12,097,253 (RSV RNA MOLECULES AND COMPOSITIONS FOR VACCINATION) - sequence listing, part 11

SEQ ID NO: 15107 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut2 (opt3)
  source 1..1814: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15108 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut2 (opt4)
  source 1..1814: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15109 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut2 (opt5)
  source 1..1814: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15110 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut2 (opt6)
  source 1..1814: mol_type = other RNA
gggagagcctctgctggagtccggggagtggcgttggctgctagagcgaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15111 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut2 (opt11)
  source 1..1814: mol_type = other RNA
gggagagcctctgctggagtccggggagtggcgttggctgctagagcgaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15112 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut2 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15113 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut2 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15114 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut2 (opt2)
  source 1..1834: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15115 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut2 (opt3)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15116 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut2 (opt4)
  source 1..1834: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15117 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut2 (opt5)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15118 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut2 (opt6)
  source 1..1834: mol_type = other RNA
gggagagtcccgcagtcggcgtccagcggctctgcttgttcgtgtgtgtgtcgttgcaggccttattcaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15119 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut2 (opt11)
  source 1..1834: mol_type = other RNA
gggagagtcccgcagtcggcgtccagcggctctgcttgttcgtgtgtgtgtcgttgcaggccttattcaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15120 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut2 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15121 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut2 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15122 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut2 (opt2)
  source 1..1885: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15123 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut2 (opt3)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15124 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut2 (opt4)
  source 1..1885: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15125 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut2 (opt5)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15126 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut2 (opt6)
  source 1..1885: mol_type = other RNA
gggagagtcccgcagtcggcgtccagcggctctgcttgttcgtgtgtgtgtcgttgcaggccttattcaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15127 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut2 (opt11)
  source 1..1885: mol_type = other RNA
gggagagtcccgcagtcggcgtccagcggctctgcttgttcgtgtgtgtgtcgttgcaggccttattcaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15128 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut2 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15129 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut2 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15130 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut2 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15131 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut2 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15132 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut2 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15133 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut2 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15134 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut2 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15135 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut2 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15136 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut2 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15137 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut2 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15138 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut2 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15139 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut2 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15140 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut2 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15141 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut2 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15142 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut2 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15143 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut2 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15144 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut2 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15145 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut2 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15146 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut2 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15147 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut2 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15148 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut2 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15149 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut2 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15150 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut2 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15151 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut2 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15152 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut2 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15153 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut2 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15154 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut2 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15155 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut2 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15156 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut2 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15157 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut2 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15158 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut2 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15159 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut2 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15160 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut2 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15161 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut2 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15162 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut2 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15163 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut2 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15164 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut2 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15165 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut2 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15166 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut2 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15167 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut2 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15168 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut2 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15169 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut2 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15170 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut2 (opt2)
  source 1..1834: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15171 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut2 (opt3)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15172 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut2 (opt4)
  source 1..1834: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15173 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut2 (opt5)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15174 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut2 (opt6)
  source 1..1834: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15175 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut2 (opt11)
  source 1..1834: mol_type = other RNA
gggagagcggctcggccattttgtcccagtcagtccggaggctgcggctgcagaagtaccgcctgcggagtaactgcaaagaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15176 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut2 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15177 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut2 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15178 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut2 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15179 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut2 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15180 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut2 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15181 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut2 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15182 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut2 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15183 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut2 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15184 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut2 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15185 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut2 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15186 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut2 (opt2)
  source 1..1898: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15187 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut2 (opt3)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15188 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut2 (opt4)
  source 1..1898: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15189 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut2 (opt5)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15190 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut2 (opt6)
  source 1..1898: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15191 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut2 (opt11)
  source 1..1898: mol_type = other RNA
gggagagcggctcggccattttgtcccagtcagtccggaggctgcggctgcagaagtaccgcctgcggagtaactgcaaagaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15192 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut2 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15193 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut2 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15194 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut2 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15195 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut2 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15196 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut2 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15197 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut2 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15198 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut2 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15199 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut2 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15200 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut2 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15201 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut2 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15202 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut2 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15203 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut2 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15204 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut2 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15205 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut2 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15206 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut2 (opt6)
  source 1..1897: mol_type = other RNA
gggagagtcccgcagtcggcgtccagcggctctgcttgttcgtgtgtgtgtcgttgcaggccttattcaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15207 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut2 (opt11)
  source 1..1897: mol_type = other RNA
gggagagtcccgcagtcggcgtccagcggctctgcttgttcgtgtgtgtgtcgttgcaggccttattcaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15208 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut2 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15209 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut2 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15210 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut2 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15211 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut2 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15212 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut2 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15213 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut2 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15214 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut2 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15215 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut2 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15216 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut2 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15217 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut2 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15218 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut2 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15219 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut2 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15220 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut2 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15221 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut2 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15222 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut2 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15223 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut2 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15224 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut2 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15225 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut2 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15226 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut2 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15227 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut2 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15228 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut2 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15229 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut2 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15230 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut2 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15231 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut2 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15232 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut2 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15233 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut2 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15234 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut2 (opt2)
  source 1..1826: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15235 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut2 (opt3)
  source 1..1826: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15236 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut2 (opt4)
  source 1..1826: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15237 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut2 (opt5)
  source 1..1826: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15238 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut2 (opt6)
  source 1..1826: mol_type = other RNA
gggagactttcccattctgtagcagaatttggtgttgcctgtggtcttggtcccgcggagaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15239 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut2 (opt11)
  source 1..1826: mol_type = other RNA
gggagactttcccattctgtagcagaatttggtgttgcctgtggtcttggtcccgcggagaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15240 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut2 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15241 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut2 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15242 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut2 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15243 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut2 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15244 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut2 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15245 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut2 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15246 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut2 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15247 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut2 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15248 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut2 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15249 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut2 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15250 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut2 (opt2)
  source 1..1847: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15251 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut2 (opt3)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15252 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut2 (opt4)
  source 1..1847: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15253 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut2 (opt5)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15254 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut2 (opt6)
  source 1..1847: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15255 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut2 (opt11)
  source 1..1847: mol_type = other RNA
gggagagcggctcggccattttgtcccagtcagtccggaggctgcggctgcagaagtaccgcctgcggagtaactgcaaagaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15256 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut2 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15257 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut2 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15258 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut2 (opt2)
  source 1..1914: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15259 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut2 (opt3)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15260 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut2 (opt4)
  source 1..1914: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15261 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut2 (opt5)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15262 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut2 (opt6)
  source 1..1914: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15263 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut2 (opt11)
  source 1..1914: mol_type = other RNA
gggagagcggctcggccattttgtcccagtcagtccggaggctgcggctgcagaagtaccgcctgcggagtaactgcaaagaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15264 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut2 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15265 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut2 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15266 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut2 (opt2)
  source 1..2130: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15267 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut2 (opt3)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15268 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut2 (opt4)
  source 1..2130: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15269 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut2 (opt5)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15270 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut2 (opt6)
  source 1..2130: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15271 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut2 (opt11)
  source 1..2130: mol_type = other RNA
gggagagcggctcggccattttgtcccagtcagtccggaggctgcggctgcagaagtaccgcctgcggagtaactgcaaagaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15272 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut2 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15273 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut2 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15274 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut2 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15275 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut2 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15276 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut2 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15277 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut2 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15278 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut2 (opt6)
  source 1..1910: mol_type = other RNA
gggagagcggctcggccattttgtcccagtcagtccggaggctgcggctgcagaagtaccgcctgcggagtaactgcaaagaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15279 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut2 (opt11)
  source 1..1910: mol_type = other RNA
gggagagcggctcggccattttgtcccagtcagtccggaggctgcggctgcagaagtaccgcctgcggagtaactgcaaagaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15280 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut2 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15281 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut2 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15282 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut2 (opt2)
  source 1..1901: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15283 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut2 (opt3)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15284 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut2 (opt4)
  source 1..1901: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15285 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut2 (opt5)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15286 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut2 (opt6)
  source 1..1901: mol_type = other RNA
gggagagtcccgcagtcggcgtccagcggctctgcttgttcgtgtgtgtgtcgttgcaggccttattcaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15287 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut2 (opt11)
  source 1..1901: mol_type = other RNA
gggagagtcccgcagtcggcgtccagcggctctgcttgttcgtgtgtgtgtcgttgcaggccttattcaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15288 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut2 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15289 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut2 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15290 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut2 (opt2)
  source 1..2117: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15291 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut2 (opt3)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15292 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut2 (opt4)
  source 1..2117: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15293 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut2 (opt5)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15294 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut2 (opt6)
  source 1..2117: mol_type = other RNA
gggagagtcccgcagtcggcgtccagcggctctgcttgttcgtgtgtgtgtcgttgcaggccttattcaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15295 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut2 (opt11)
  source 1..2117: mol_type = other RNA
gggagagtcccgcagtcggcgtccagcggctctgcttgttcgtgtgtgtgtcgttgcaggccttattcaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15296 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut2 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15297 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut2 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15298 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut2 (opt2)
  source 1..1893: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15299 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut2 (opt3)
  source 1..1893: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15300 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut2 (opt4)
  source 1..1893: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15301 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut2 (opt5)
  source 1..1893: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15302 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut2 (opt6)
  source 1..1893: mol_type = other RNA
gggagactttcccattctgtagcagaatttggtgttgcctgtggtcttggtcccgcggagaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15303 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut2 (opt11)
  source 1..1893: mol_type = other RNA
gggagactttcccattctgtagcagaatttggtgttgcctgtggtcttggtcccgcggagaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15304 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut2 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15305 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut2 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15306 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut2 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15307 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut2 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15308 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut2 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15309 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut2 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15310 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut2 (opt6)
  source 1..1889: mol_type = other RNA
gggagactttcccattctgtagcagaatttggtgttgcctgtggtcttggtcccgcggagaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15311 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut2 (opt11)
  source 1..1889: mol_type = other RNA
gggagactttcccattctgtagcagaatttggtgttgcctgtggtcttggtcccgcggagaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15312 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut2 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15313 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut2 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15314 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut2 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15315 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut2 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15316 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut2 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15317 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut2 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15318 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut2 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15319 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut2 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15320 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut2 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15321 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut2 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15322 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut2 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15323 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut2 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15324 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut2 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15325 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut2 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15326 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut2 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15327 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut2 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15328 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut2 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15329 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut2 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15330 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut2 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15331 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut2 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15332 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut2 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15333 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut2 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15334 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut2 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15335 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut2 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15336 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut2 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15337 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut2 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15338 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut2 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15339 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut2 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15340 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut2 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15341 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut2 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15342 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut2 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15343 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut2 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15344 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut2 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15345 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut2 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15346 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut2 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15347 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut2 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15348 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut2 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15349 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut2 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15350 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut2 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15351 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut2 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15352 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut2 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15353 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut2 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15354 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut2 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15355 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut2 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15356 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut2 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15357 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut2 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15358 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut2 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15359 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut2 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15360 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut2 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15361 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut2 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15362 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut2 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15363 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut2 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15364 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut2 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15365 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut2 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15366 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut2 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15367 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut2 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15368 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut2 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15369 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut2 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15370 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut2 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15371 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut2 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15372 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut2 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15373 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut2 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15374 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut2 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15375 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut2 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15376 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut2 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15377 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut2 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15378 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut2 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15379 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut2 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15380 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut2 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15381 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut2 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15382 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut2 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15383 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut2 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15384 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut2 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15385 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut2 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15386 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut2 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15387 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut2 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15388 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut2 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15389 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut2 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15390 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut2 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15391 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut2 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15392 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut2 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15393 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut2 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15394 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut2 (opt2)
  source 1..1931: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15395 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut2 (opt3)
  source 1..1931: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15396 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut2 (opt4)
  source 1..1931: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15397 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut2 (opt5)
  source 1..1931: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15398 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut2 (opt6)
  source 1..1931: mol_type = other RNA
gggagaggcgctgcctacggaggtggcagccatctccttctcggcatcaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15399 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut2 (opt11)
  source 1..1931: mol_type = other RNA
gggagaggcgctgcctacggaggtggcagccatctccttctcggcatcaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15400 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut2 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15401 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut2 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15402 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut2 (opt2)
  source 1..1927: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15403 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut2 (opt3)
  source 1..1927: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15404 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut2 (opt4)
  source 1..1927: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15405 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut2 (opt5)
  source 1..1927: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15406 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut2 (opt6)
  source 1..1927: mol_type = other RNA
ggggcgctgcctacggaggtggcagccatctccttctcggcatcaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15407 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut2 (opt11)
  source 1..1927: mol_type = other RNA
ggggcgctgcctacggaggtggcagccatctccttctcggcatcaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15408 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut2 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15409 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut2 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15410 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut2 (opt2)
  source 1..1762: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15411 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut2 (opt3)
  source 1..1762: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagcttctgatgcagtctactcctgccgctggctcggggtcagcaatatgtagcggaatcgccgtgtgcaaggtcttgcacctcgagggcgaggtgaacaaaattaagaatgctctgctgagtaccaacaaagccgttgtgtccctctctaatggtgtcagcgtgttaacgttcaaggtactggatcttaagaactacatcgacaaacaattgctgccaattctaaataagcagtcctgttcaatcccgaacatagaaactgttattgagtttcagcagaaaaataacaggctcctggaaatcacccgggagttcagtgtgaatgcgggggtcacaactcccgtgagcacctatatgcttacaaactctgagctgttgtccctcattaacgatatgcctatcaccaatgaccaaaagaaactgatgtcaaacaatgtgcagatcgtccgccagcagagctacagtattatgtgcataatcaaggaagaggttttagcatatgtggtacaactgccactctacggagtgattgatacgccctgttggaaacttcatacttctcctctgtgcacaaccaacactaaggaaggctccaatatctgtttgacacgaaccgaccgtggctggtactgcgataacgccgggagcgtctcgtttttcccacaggctgagacgtgtaaggtgcagtctaatagagttttctgcgacaccatgaactccctaacactgccctcagaagtgaatctctgcaacatagatattttcaatcctaaatatgactgtaagatcatgacaagtaaaaccgatgtcagctcctctgtgatcacaagcctgggagccattgtatcatgctacggtaagactaaatgtaccgcaagtaacaagaataggggcatcattaagacattttccaacgggtgcgactatgttagcaataaaggagtggacaccgtctctgtgggcaacactctttactgtgtcaacaagcaagagggtcagtcactgtatgtgaaaggggagccaataatcaatttctacgatccgttggtttttcccagtgacgaatttgatgctagcatttcccaggtgaacgagaagatcaatcagtctctcgcctttatccggaaatcggacgaactgttacacaacgtaaatgtcggaaagagcacgacaaacattatgataaccactatcattatcgtgattatcgttatactgctactcctgatcgcggtgggccttttcttgtattgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15412 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut2 (opt4)
  source 1..1762: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15413 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut2 (opt5)
  source 1..1762: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagctgctgatgcagtccacccctgccgctgggtctggaagcgccatttgttccggcatcgcggtctgcaaggtgctccacctggagggggaggttaacaaaattaagaatgcccttctgagcacaaacaaagctgtggtctctctctccaatggagtgagcgttctgaccttcaaggtgcttgatctgaagaactacatcgacaaacaactcctgccgattctgaataagcagtcttgttccatccccaacattgaaacagtcatcgagtttcagcagaaaaataaccggctcctggaaatcacccgcgagttcagcgtgaatgccggcgtgacgacacctgtctctacctatatgcttacaaactccgagctgctcagcctgattaacgatatgcccatcaccaatgaccaaaagaaacttatgtccaacaatgttcagattgtgagacagcagtcttacagcatcatgtgcattatcaaggaagaggtgctggcttatgtcgtgcaactccctctgtacggcgttatcgataccccctgttggaaactgcatacatcccctctctgcacgaccaacacaaaggaagggagcaatatttgtctgacccggacagaccgcggatggtactgcgataacgccggctctgtgtcctttttcccgcaggcggagacctgtaaggtccagagcaatagagtgttttgcgacacgatgaactctcttacactgcccagcgaagttaatctctgcaacatcgatattttcaatcctaaatatgactgtaagatcatgacctccaaaaccgatgtgtctagctccgtcattacaagcctgggggccatcgtgtcttgctacggaaagaccaaatgtacagcttccaacaagaatcggggcatcattaagacgtttagcaacgggtgcgactatgtctctaataaaggagtggacaccgtttccgtgggcaacacactttactgtgtcaacaagcaagagggccagagcctgtatgtgaaaggggagcccatcattaatttctacgatcctctcgtttttccctccgacgagttcgatgcctctatcagccaggtgaacgaaaagattaatcagtccctggcttttatccgcaaatctgacgaactgctccacaacgtcaatgtgggaaagagcaccacaaacattatgatcaccacgatcattatcgtgattatcgttattctgcttctgctcatcgccgtcggcctgttcctgtattgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15414 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut2 (opt6)
  source 1..1762: mol_type = other RNA
gggagaaagcttaccatggaactaccaatactcaaaacaaacgcaataacaacaattttagctgcagtaacactttgtttcgcatcctcccaaaatataacagaagaattttatcaatcaacctgctcagccgtctccaaaggatatctaggtgcactacgcactggatggtacacaagtgtcatcacaatagaactttccaacatcaaagaaaataaatgtaatggaactgacgcaaaagtaaaactcataaaacaagaactagacaaatacaaaaacgcagtaacagacctacaactattaatgcaatcaacaccagcagcaggatccggcagtgccatatgctctggaatagcagtctgcaaagttttacacttagaaggcgaagtaaacaaaatcaaaaacgccctactatctacaaataaagccgtcgtatctctctcaaatggagtatcagtactaacattcaaagtattagacttaaaaaactacatcgataaacaattattgccaatattaaacaaacaatcttgctcaataccaaatatagaaacagtcatagaatttcaacaaaaaaataaccgattattagaaataacacgagaattttcagtaaatgccggagtcaccacaccagtatcaacatacatgctaacaaattcagaactattatcattaataaacgacatgcctattacaaatgatcaaaaaaaactaatgtccaacaatgtacaaatagtccgacaacaaagctactcaatcatgtgtataataaaagaagaagtacttgcatacgtagtacaattaccactatacggagttatcgacacaccatgctggaaactccacacttcaccactctgcaccacaaacacaaaagaaggctcaaacatatgcctaacaagaacagaccgaggatggtactgcgacaacgcaggatcagtatcattcttcccacaagcagaaacttgcaaagtacaatctaacagagttttctgtgacaccatgaatagcctaacactcccctccgaagttaacctatgtaacatagatatatttaatcccaaatatgattgcaaaatcatgacatctaaaaccgacgtatcatcatctgtaatcacatcactaggtgccatagtctcatgctacggcaaaacaaaatgcaccgcctcaaacaaaaaccgaggtataataaaaaccttcagtaatggatgtgactacgtatcaaacaaaggtgttgataccgtaagcgtcggcaacaccctatactgcgtaaataaacaagaaggccaatcactatacgtcaaaggcgaaccaattattaacttctatgacccactcgtctttccctccgacgaatttgacgcaagcatatcacaagtaaacgaaaaaataaaccaatcactagcattcatacgcaaatcagatgaactactacataacgtaaacgtaggaaaatccactacaaatataatgatcacaacaataataatcgtaattatagtcatattattactactaatagcagtaggacttttcctatactgtaaagcaagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15415 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut2 (opt11)
  source 1..1762: mol_type = other RNA
gggagaaagcttaccatggaacttcccatcctcaagaccaacgctattacgaccatcctcgccgcagtcaccctctgcttcgcgtcatcccaaaacatcaccgaagaattttaccaatccacatgctccgcagtctcaaaaggctacctaggagccctacgcaccggatggtacacatccgtcatcacaatcgaactctccaacataaaagaaaacaaatgcaacggcaccgatgccaaagtaaaactgattaaacaagaactcgacaaatacaagaacgccgtcacagacctacagctcctcatgcaatcaactcccgccgccggcagcggatccgctatctgctcaggcatcgccgtatgcaaagtcctccacctagaaggcgaagtaaacaaaatcaagaacgcactactctcaacaaacaaagccgtcgtctccctctccaacggcgtctccgtccttaccttcaaagtcctcgaccttaagaactacattgacaaacaactcctacccatcctcaacaaacaatcctgctctatacctaatatagaaaccgtaatcgaatttcaacagaaaaacaaccgcctcctcgaaattacccgcgagttctcagtaaacgccggcgtaaccacccccgtctccacctacatgctcacaaattcagaactcctcagcctcatcaacgacatgcccataaccaacgaccaaaagaaactcatgtcaaacaacgtccaaatcgtcaggcaacaaagctacagcatcatgtgcatcattaaagaagaagtactcgcctacgtcgtgcaactacccctctacggcgtcatagacacaccctgctggaaacttcacacatcaccgctctgcaccacaaacaccaaagaaggcagtaacatatgcctcacccgaaccgaccgcggatggtactgcgacaacgccggatccgtcagcttcttcccacaagccgaaacctgcaaagtacaatccaaccgagtcttctgcgacaccatgaactctcttacgctcccctcagaagtcaacctatgcaacatcgacatcttcaaccccaaatacgactgcaaaatcatgacctccaaaacagacgtctcctcctcagtgataacctccctcggcgccattgtctcctgctacggcaaaaccaaatgcaccgcctccaacaaaaaccgtgggatcatcaaaaccttctcaaacggctgcgactacgtatccaataagggtgtcgacacagtctccgtaggcaataccctctattgcgtcaacaaacaagaaggccaatccctctacgtcaaaggcgaacctatcatcaacttctacgacccgctagtcttcccctcagacgagttcgacgcatccatctcacaagtcaacgaaaagatcaaccagtccctcgcattcatccgaaaatccgacgaacttctccacaacgttaacgtcggcaaatccaccactaacataatgatcaccacgatcatcatagtaattatcgtcatactcctcctcctaatcgctgtcggactcttcctctactgcaaggcccgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15416 - protein, 535 aa, synthetic construct
  REGION 1..535: note = derived and/or modified protein sequence (artificial) from HRSV(Memphis-37)__AIY60640.1__F_DSCav1_mut3
MELPILKTNAITTILAAVTLCFASSQNITEEFYQSTCSAVSKGYLGALRTGWYTSVITIELSNIKEIKCNGTDAKVKLIKQELDKYKNAVTDLQLLMQSTPAAGSGSAICSGIAVCKVLHLEGEVNKIKNALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 15417 - RNA, 1608 nt, synthetic construct
  misc_feature 1..1608: note = derived and/or modified CDS sequence (opt1) from HRSV(Memphis-37)__AIY60640.1__F_DSCav1_mut3
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 15418 - RNA, 1608 nt, synthetic construct
  misc_feature 1..1608: note = derived and/or modified CDS sequence (opt1) from HRSV(Memphis-37)__AIY60640.1__F_DSCav1_mut3
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactga

SEQ ID NO: 15419 - RNA, 1608 nt, synthetic construct
  misc_feature 1..1608: note = derived and/or modified CDS sequence (opt2) from HRSV(Memphis-37)__AIY60640.1__F_DSCav1_mut3
  source 1..1608: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 15420 - RNA, 1608 nt, synthetic construct
  misc_feature 1..1608: note = derived and/or modified CDS sequence (opt3) from HRSV(Memphis-37)__AIY60640.1__F_DSCav1_mut3
  source 1..1608: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactga

SEQ ID NO: 15421 - RNA, 1608 nt, synthetic construct
  misc_feature 1..1608: note = derived and/or modified CDS sequence (opt4) from HRSV(Memphis-37)__AIY60640.1__F_DSCav1_mut3
  source 1..1608: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 15422 - RNA, 1608 nt, synthetic construct
  misc_feature 1..1608: note = derived and/or modified CDS sequence (opt5) from HRSV(Memphis-37)__AIY60640.1__F_DSCav1_mut3
  source 1..1608: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactga

SEQ ID NO: 15423 - RNA, 1608 nt, synthetic construct
  misc_feature 1..1608: note = derived and/or modified CDS sequence (opt6) from HRSV(Memphis-37)__AIY60640.1__F_DSCav1_mut3
  source 1..1608: mol_type = other RNA
atggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaa

SEQ ID NO: 15424 - RNA, 1608 nt, synthetic construct
  misc_feature 1..1608: note = derived and/or modified CDS sequence (opt11) from HRSV(Memphis-37)__AIY60640.1__F_DSCav1_mut3
  source 1..1608: mol_type = other RNA
atggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaa

SEQ ID NO: 15425 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut3 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15426 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut3 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15427 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut3 (opt2)
  source 1..1884: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15428 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut3 (opt3)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15429 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut3 (opt4)
  source 1..1884: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15430 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut3 (opt5)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15431 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut3 (opt6)
  source 1..1884: mol_type = other RNA
gggagagtcccgcagtcggcgtccagcggctctgcttgttcgtgtgtgtgtcgttgcaggccttattcaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15432 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut3 (opt11)
  source 1..1884: mol_type = other RNA
gggagagtcccgcagtcggcgtccagcggctctgcttgttcgtgtgtgtgtcgttgcaggccttattcaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15433 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut3 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15434 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut3 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15435 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut3 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15436 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut3 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15437 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut3 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15438 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut3 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15439 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut3 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15440 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut3 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15441 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut3 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15442 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut3 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15443 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut3 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15444 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut3 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15445 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut3 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15446 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut3 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15447 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut3 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15448 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut3 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15449 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut3 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15450 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut3 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15451 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut3 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15452 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut3 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15453 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut3 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15454 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut3 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15455 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut3 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15456 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut3 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15457 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut3 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15458 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut3 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15459 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut3 (opt2)
  source 1..1876: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15460 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut3 (opt3)
  source 1..1876: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15461 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut3 (opt4)
  source 1..1876: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15462 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut3 (opt5)
  source 1..1876: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15463 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut3 (opt6)
  source 1..1876: mol_type = other RNA
gggagactttcccattctgtagcagaatttggtgttgcctgtggtcttggtcccgcggagaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15464 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut3 (opt11)
  source 1..1876: mol_type = other RNA
gggagactttcccattctgtagcagaatttggtgttgcctgtggtcttggtcccgcggagaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15465 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut3 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15466 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut3 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15467 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut3 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15468 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut3 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15469 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut3 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15470 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut3 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15471 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut3 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15472 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut3 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15473 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut3 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15474 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut3 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15475 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut3 (opt2)
  source 1..1877: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15476 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut3 (opt3)
  source 1..1877: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15477 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut3 (opt4)
  source 1..1877: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15478 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut3 (opt5)
  source 1..1877: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15479 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut3 (opt6)
  source 1..1877: mol_type = other RNA
gggagagcctctgctggagtccggggagtggcgttggctgctagagcgaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15480 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut3 (opt11)
  source 1..1877: mol_type = other RNA
gggagagcctctgctggagtccggggagtggcgttggctgctagagcgaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15481 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut3 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15482 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut3 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15483 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut3 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15484 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut3 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15485 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut3 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15486 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut3 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15487 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut3 (opt6)
  source 1..1897: mol_type = other RNA
gggagagtcccgcagtcggcgtccagcggctctgcttgttcgtgtgtgtgtcgttgcaggccttattcaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15488 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut3 (opt11)
  source 1..1897: mol_type = other RNA
gggagagtcccgcagtcggcgtccagcggctctgcttgttcgtgtgtgtgtcgttgcaggccttattcaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15489 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut3 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15490 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut3 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15491 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut3 (opt2)
  source 1..1948: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15492 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut3 (opt3)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15493 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut3 (opt4)
  source 1..1948: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15494 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut3 (opt5)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15495 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut3 (opt6)
  source 1..1948: mol_type = other RNA
gggagagtcccgcagtcggcgtccagcggctctgcttgttcgtgtgtgtgtcgttgcaggccttattcaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15496 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut3 (opt11)
  source 1..1948: mol_type = other RNA
gggagagtcccgcagtcggcgtccagcggctctgcttgttcgtgtgtgtgtcgttgcaggccttattcaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15497 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut3 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15498 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut3 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15499 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut3 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15500 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut3 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15501 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut3 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15502 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut3 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15503 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut3 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15504 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut3 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15505 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut3 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15506 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut3 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15507 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut3 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15508 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut3 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15509 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut3 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15510 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut3 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15511 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut3 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15512 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut3 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15513 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut3 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15514 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut3 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15515 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut3 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15516 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut3 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15517 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut3 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15518 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut3 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15519 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut3 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15520 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut3 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15521 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut3 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15522 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut3 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15523 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut3 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15524 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut3 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15525 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut3 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15526 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut3 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15527 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut3 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15528 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut3 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15529 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut3 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15530 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut3 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15531 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut3 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15532 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut3 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15533 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut3 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15534 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut3 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15535 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut3 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15536 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut3 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15537 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut3 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15538 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut3 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15539 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut3 (opt2)
  source 1..1897: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15540 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut3 (opt3)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15541 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut3 (opt4)
  source 1..1897: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15542 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut3 (opt5)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15543 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut3 (opt6)
  source 1..1897: mol_type = other RNA
gggagagcggctcggccattttgtcccagtcagtccggaggctgcggctgcagaagtaccgcctgcggagtaactgcaaagaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15544 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut3 (opt11)
  source 1..1897: mol_type = other RNA
gggagagcggctcggccattttgtcccagtcagtccggaggctgcggctgcagaagtaccgcctgcggagtaactgcaaagaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15545 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut3 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15546 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut3 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15547 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut3 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15548 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut3 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15549 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut3 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15550 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut3 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15551 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut3 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15552 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut3 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15553 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut3 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15554 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut3 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15555 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut3 (opt2)
  source 1..1961: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15556 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut3 (opt3)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15557 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut3 (opt4)
  source 1..1961: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15558 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut3 (opt5)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15559 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut3 (opt6)
  source 1..1961: mol_type = other RNA
gggagagcggctcggccattttgtcccagtcagtccggaggctgcggctgcagaagtaccgcctgcggagtaactgcaaagaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15560 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut3 (opt11)
  source 1..1961: mol_type = other RNA
gggagagcggctcggccattttgtcccagtcagtccggaggctgcggctgcagaagtaccgcctgcggagtaactgcaaagaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15561 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut3 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15562 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut3 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15563 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut3 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15564 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut3 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15565 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut3 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15566 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut3 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15567 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut3 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15568 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut3 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15569 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut3 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15570 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut3 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15571 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut3 (opt2)
  source 1..1960: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15572 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut3 (opt3)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15573 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut3 (opt4)
  source 1..1960: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15574 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut3 (opt5)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15575 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut3 (opt6)
  source 1..1960: mol_type = other RNA
gggagagtcccgcagtcggcgtccagcggctctgcttgttcgtgtgtgtgtcgttgcaggccttattcaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15576 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut3 (opt11)
  source 1..1960: mol_type = other RNA
gggagagtcccgcagtcggcgtccagcggctctgcttgttcgtgtgtgtgtcgttgcaggccttattcaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15577 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut3 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15578 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut3 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15579 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut3 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15580 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut3 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15581 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut3 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15582 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut3 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15583 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut3 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15584 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut3 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15585 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut3 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15586 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut3 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15587 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut3 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15588 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut3 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15589 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut3 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15590 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut3 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15591 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut3 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15592 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut3 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15593 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut3 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15594 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut3 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15595 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut3 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15596 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut3 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15597 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut3 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15598 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut3 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15599 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut3 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15600 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut3 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15601 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut3 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15602 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut3 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15603 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut3 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15604 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut3 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15605 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut3 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15606 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut3 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15607 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut3 (opt6)
  source 1..1889: mol_type = other RNA
gggagactttcccattctgtagcagaatttggtgttgcctgtggtcttggtcccgcggagaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15608 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut3 (opt11)
  source 1..1889: mol_type = other RNA
gggagactttcccattctgtagcagaatttggtgttgcctgtggtcttggtcccgcggagaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15609 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut3 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15610 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut3 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15611 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut3 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15612 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut3 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15613 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut3 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15614 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut3 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15615 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut3 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15616 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut3 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15617 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut3 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15618 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut3 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15619 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut3 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15620 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut3 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15621 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut3 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15622 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut3 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15623 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut3 (opt6)
  source 1..1910: mol_type = other RNA
gggagagcggctcggccattttgtcccagtcagtccggaggctgcggctgcagaagtaccgcctgcggagtaactgcaaagaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15624 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut3 (opt11)
  source 1..1910: mol_type = other RNA
gggagagcggctcggccattttgtcccagtcagtccggaggctgcggctgcagaagtaccgcctgcggagtaactgcaaagaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15625 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut3 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15626 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut3 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15627 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut3 (opt2)
  source 1..1977: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15628 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut3 (opt3)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15629 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut3 (opt4)
  source 1..1977: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15630 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut3 (opt5)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15631 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut3 (opt6)
  source 1..1977: mol_type = other RNA
gggagagcggctcggccattttgtcccagtcagtccggaggctgcggctgcagaagtaccgcctgcggagtaactgcaaagaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15632 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut3 (opt11)
  source 1..1977: mol_type = other RNA
gggagagcggctcggccattttgtcccagtcagtccggaggctgcggctgcagaagtaccgcctgcggagtaactgcaaagaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15633 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut3 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15634 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut3 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15635 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut3 (opt2)
  source 1..2193: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15636 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut3 (opt3)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15637 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut3 (opt4)
  source 1..2193: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15638 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut3 (opt5)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15639 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut3 (opt6)
  source 1..2193: mol_type = other RNA
gggagagcggctcggccattttgtcccagtcagtccggaggctgcggctgcagaagtaccgcctgcggagtaactgcaaagaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15640 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut3 (opt11)
  source 1..2193: mol_type = other RNA
gggagagcggctcggccattttgtcccagtcagtccggaggctgcggctgcagaagtaccgcctgcggagtaactgcaaagaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15641 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut3 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15642 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut3 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15643 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut3 (opt2)
  source 1..1973: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15644 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut3 (opt3)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15645 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut3 (opt4)
  source 1..1973: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15646 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut3 (opt5)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15647 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut3 (opt6)
  source 1..1973: mol_type = other RNA
gggagagcggctcggccattttgtcccagtcagtccggaggctgcggctgcagaagtaccgcctgcggagtaactgcaaagaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15648 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut3 (opt11)
  source 1..1973: mol_type = other RNA
gggagagcggctcggccattttgtcccagtcagtccggaggctgcggctgcagaagtaccgcctgcggagtaactgcaaagaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15649 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut3 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15650 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut3 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15651 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut3 (opt2)
  source 1..1964: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15652 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut3 (opt3)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15653 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut3 (opt4)
  source 1..1964: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15654 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut3 (opt5)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15655 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut3 (opt6)
  source 1..1964: mol_type = other RNA
gggagagtcccgcagtcggcgtccagcggctctgcttgttcgtgtgtgtgtcgttgcaggccttattcaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15656 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut3 (opt11)
  source 1..1964: mol_type = other RNA
gggagagtcccgcagtcggcgtccagcggctctgcttgttcgtgtgtgtgtcgttgcaggccttattcaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15657 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut3 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15658 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut3 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15659 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut3 (opt2)
  source 1..2180: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15660 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut3 (opt3)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15661 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut3 (opt4)
  source 1..2180: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15662 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut3 (opt5)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15663 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut3 (opt6)
  source 1..2180: mol_type = other RNA
gggagagtcccgcagtcggcgtccagcggctctgcttgttcgtgtgtgtgtcgttgcaggccttattcaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15664 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut3 (opt11)
  source 1..2180: mol_type = other RNA
gggagagtcccgcagtcggcgtccagcggctctgcttgttcgtgtgtgtgtcgttgcaggccttattcaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15665 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut3 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15666 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut3 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15667 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut3 (opt2)
  source 1..1956: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15668 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut3 (opt3)
  source 1..1956: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15669 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut3 (opt4)
  source 1..1956: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15670 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut3 (opt5)
  source 1..1956: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15671 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut3 (opt6)
  source 1..1956: mol_type = other RNA
gggagactttcccattctgtagcagaatttggtgttgcctgtggtcttggtcccgcggagaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15672 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut3 (opt11)
  source 1..1956: mol_type = other RNA
gggagactttcccattctgtagcagaatttggtgttgcctgtggtcttggtcccgcggagaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15673 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut3 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15674 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut3 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15675 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut3 (opt2)
  source 1..1952: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15676 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut3 (opt3)
  source 1..1952: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15677 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut3 (opt4)
  source 1..1952: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15678 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut3 (opt5)
  source 1..1952: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15679 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut3 (opt6)
  source 1..1952: mol_type = other RNA
gggagactttcccattctgtagcagaatttggtgttgcctgtggtcttggtcccgcggagaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15680 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut3 (opt11)
  source 1..1952: mol_type = other RNA
gggagactttcccattctgtagcagaatttggtgttgcctgtggtcttggtcccgcggagaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15681 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut3 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15682 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut3 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15683 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut3 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15684 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut3 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15685 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut3 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15686 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut3 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15687 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut3 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15688 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut3 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15689 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut3 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15690 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut3 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15691 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut3 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15692 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut3 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15693 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut3 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15694 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut3 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15695 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut3 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15696 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut3 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15697 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut3 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15698 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut3 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15699 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut3 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15700 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut3 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15701 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut3 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15702 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut3 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15703 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut3 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15704 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut3 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15705 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut3 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15706 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut3 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15707 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut3 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15708 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut3 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15709 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut3 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15710 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut3 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15711 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut3 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15712 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut3 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15713 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut3 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15714 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut3 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15715 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut3 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15716 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut3 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15717 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut3 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15718 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut3 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15719 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut3 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15720 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut3 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15721 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut3 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15722 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut3 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15723 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut3 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15724 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut3 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15725 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut3 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15726 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut3 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15727 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut3 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15728 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut3 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15729 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut3 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15730 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut3 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15731 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut3 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15732 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut3 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15733 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut3 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15734 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut3 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15735 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut3 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15736 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut3 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15737 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut3 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15738 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut3 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15739 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut3 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15740 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut3 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15741 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut3 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15742 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut3 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15743 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut3 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15744 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut3 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15745 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut3 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15746 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut3 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15747 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut3 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15748 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut3 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15749 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut3 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15750 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut3 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15751 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut3 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15752 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut3 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15753 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut3 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15754 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut3 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15755 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut3 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15756 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut3 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15757 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut3 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15758 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut3 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15759 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut3 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15760 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut3 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15761 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut3 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15762 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut3 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15763 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut3 (opt2)
  source 1..1994: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15764 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut3 (opt3)
  source 1..1994: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15765 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut3 (opt4)
  source 1..1994: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15766 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut3 (opt5)
  source 1..1994: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15767 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut3 (opt6)
  source 1..1994: mol_type = other RNA
gggagaggcgctgcctacggaggtggcagccatctccttctcggcatcaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15768 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut3 (opt11)
  source 1..1994: mol_type = other RNA
gggagaggcgctgcctacggaggtggcagccatctccttctcggcatcaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15769 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut3 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15770 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut3 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15771 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut3 (opt2)
  source 1..1990: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15772 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut3 (opt3)
  source 1..1990: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15773 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut3 (opt4)
  source 1..1990: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15774 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut3 (opt5)
  source 1..1990: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15775 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut3 (opt6)
  source 1..1990: mol_type = other RNA
ggggcgctgcctacggaggtggcagccatctccttctcggcatcaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15776 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut3 (opt11)
  source 1..1990: mol_type = other RNA
ggggcgctgcctacggaggtggcagccatctccttctcggcatcaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15777 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut3 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15778 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut3 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggagcacgcccgtgaccctgtccaaggaccagctcagcgggatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15779 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut3 (opt2)
  source 1..1825: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15780 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut3 (opt3)
  source 1..1825: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctccacccctgtcacactgtcaaaagatcaactcagtggcatcaacaatattgcattctctaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15781 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut3 (opt4)
  source 1..1825: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15782 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut3 (opt5)
  source 1..1825: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatccaccccggtgacacttagcaaagatcaactctctgggattaacaatatcgctttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15783 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut3 (opt6)
  source 1..1825: mol_type = other RNA
gggagaaagcttaccatggaattaccaatactaaaaacaaatgccatcaccaccatcctggccgccgtaacattatgcttcgcaagttcacaaaatataacagaagaattttatcaatcaacttgcagcgccgtatcaaaaggctacttaggcgcactacgtacaggatggtacacatcagtaataaccatagaactatccaatattaaagaaataaaatgcaatggaacagacgcaaaagttaaactaataaaacaagaattagacaaatacaaaaacgcagtaaccgaccttcaattactaatgcaatctacccccgctgcaggttccggatcagcaatatgttcaggaattgcagtatgcaaagtcctacacttagaaggagaagtaaacaaaataaaaaacgcactattaagcaccaataaagcagtcgtatcattatccaacggcgtttcagtactaacatttaaagtacttgacctaaaaaactatatagacaaacaactacttcccatccttaacaaacaaagctgctcaatacctaatatcgaaacagtaatagaatttcaacaaaaaaacaatcgattattagaaatcacacgagaattttctgtcaacgcaggagtcaccacacccgtatctacttatatgttaaccaactctgaattattatcactaatcaatgacatgccaataacaaacgatcaaaaaaaattaatgtcaaataacgtacaaatagtaagacaacaatcatactcaataatgtgcattataaaagaagaagtactagcctatgttgtacaactcccactctacggcgtaatagacacaccatgctggaaattacacacttcaccactatgcacaacaaacacaaaagaaggatcaaacatctgcctaaccagaaccgatagaggatggtattgcgacaatgccggatcagtttcattcttcccacaagcagaaacatgcaaagtacaatccaacagagttttctgtgacacaatgaactcgctaacattacccagcgaagtaaacctctgcaacatagacatattcaacccaaaatacgattgcaaaataatgacttctaaaacagatgtttcctcaagcgtcataacgagtttaggagcaatagtaagctgttacggaaaaaccaaatgtaccgcatcaaacaaaaaccgaggaataataaaaaccttttcaaacggatgcgattacgtctccaacaaaggagtcgacacagtatcagttggcaatactctttactgcgtaaataaacaagaaggacaatcactatacgtaaaaggcgaaccaataataaacttctacgaccccctcgtcttcccttcagatgaatttgacgcaagcatctcacaagttaatgaaaaaataaatcaatccttagcattcatacgaaaatcagacgaactattacacaacgtaaacgtaggaaaatcaacgacaaacataatgataacaactatcattatagtcataatagtcatactactactattaatagccgtaggcttattcctatactgcaaagcaagatctactccagtaacactctcaaaagaccaattatctggaataaataacatagcattctctaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15784 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut3 (opt11)
  source 1..1825: mol_type = other RNA
gggagaaagcttaccatggaactccccatcctcaaaaccaacgccattaccacgatcctcgccgcagtcaccctctgcttcgcctcctcacaaaacatcacagaagaattttaccaaagtacctgctccgccgtcagcaaaggatacctcggcgccctccgcaccggctggtacacatccgtcataaccatcgaactcagcaacatcaaagaaatcaaatgtaacggaaccgacgccaaagtaaaactaataaaacaagaactcgacaaatacaagaacgccgtcaccgacctccaactcctcatgcaatctacccccgccgccggctcaggtagcgccatctgcagcggtattgccgtctgcaaagtactccacctagaaggagaagtcaataaaatcaaaaacgccctactctccaccaacaaggcagtcgtcagcctctccaacggcgtctcagtcttaaccttcaaagtgctcgacctcaaaaattacatagacaaacaactactccccattctcaacaaacaatcctgctccatacccaacatagaaaccgtcattgaatttcaacagaaaaacaaccgcctcctcgaaatcacgcgcgagttcagtgtcaacgccggcgtcaccaccccagtctcgacatacatgctcacaaactcagaactcctctcgttaatcaacgacatgccaataaccaacgaccaaaagaaactaatgtccaacaacgttcaaatagttcgccaacaatcatactccataatgtgcatcatcaaagaagaagtcctcgcctacgttgtacaattacccctctacggcgtcatcgacacaccatgctggaaactccacacatcgcccctctgcaccaccaacaccaaagaaggcagcaacatttgcctcacccggacagaccgcggctggtactgcgacaatgcaggcagcgtctcattcttcccacaagccgaaacctgcaaagtccaaagcaaccgtgtcttctgcgacacaatgaactcccttaccctcccaagcgaagtaaacctctgcaatattgacatcttcaaccccaaatacgactgcaaaatcatgacctccaaaaccgacgtctcctcatcagtcatcacctcccttggcgccattgtctcctgttacggtaaaaccaaatgcaccgcctccaacaaaaaccgcggcatcatcaaaaccttctctaacggctgcgactacgtctcaaacaaaggcgtcgacactgtctccgtcggcaacaccctatactgcgtcaacaagcaagaaggacagtccctatacgtaaaaggtgaaccaattatcaacttctacgaccccctagtcttcccatccgacgagttcgatgcctccatctcccaagtaaatgaaaagatcaatcaaagcctggccttcatccgcaaatccgacgaactactccacaatgtcaacgtcggaaaatcaacaacaaacatcatgatcaccaccatcatcatcgtcatcatagtaatcctcctactgctcatcgccgtcggtctcttcctatactgcaaagcccgttctactccagtcaccctctccaaagaccaactatcaggaatcaacaacatcgccttcagcaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15785 - protein, 514 aa, synthetic construct
  REGION 1..514: note = derived and/or modified protein sequence (artificial) from HRSV(Memphis-37)__AIY60640.1__F-del_DSCav1_mut3
MELPILKTNAITTILAAVTLCFASSQNITEEFYQSTCSAVSKGYLGALRTGWYTSVITIELSNIKEIKCNGTDAKVKLIKQELDKYKNAVTDLQLLMQSTPAAGSGSAICSGIAVCKVLHLEGEVNKIKNALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 15786 - RNA, 1545 nt, synthetic construct
  misc_feature 1..1545: note = derived and/or modified CDS sequence (opt1) from HRSV(Memphis-37)__AIY60640.1__F-del_DSCav1_mut3
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 15787 - RNA, 1545 nt, synthetic construct
  misc_feature 1..1545: note = derived and/or modified CDS sequence (opt1) from HRSV(Memphis-37)__AIY60640.1__F-del_DSCav1_mut3
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtga

SEQ ID NO: 15788 - RNA, 1545 nt, synthetic construct
  misc_feature 1..1545: note = derived and/or modified CDS sequence (opt2) from HRSV(Memphis-37)__AIY60640.1__F-del_DSCav1_mut3
  source 1..1545: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 15789 - RNA, 1545 nt, synthetic construct
  misc_feature 1..1545: note = derived and/or modified CDS sequence (opt3) from HRSV(Memphis-37)__AIY60640.1__F-del_DSCav1_mut3
  source 1..1545: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctga

SEQ ID NO: 15790 - RNA, 1545 nt, synthetic construct
  misc_feature 1..1545: note = derived and/or modified CDS sequence (opt4) from HRSV(Memphis-37)__AIY60640.1__F-del_DSCav1_mut3
  source 1..1545: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 15791 - RNA, 1545 nt, synthetic construct
  misc_feature 1..1545: note = derived and/or modified CDS sequence (opt5) from HRSV(Memphis-37)__AIY60640.1__F-del_DSCav1_mut3
  source 1..1545: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatga

SEQ ID NO: 15792 - RNA, 1545 nt, synthetic construct
  misc_feature 1..1545: note = derived and/or modified CDS sequence (opt6) from HRSV(Memphis-37)__AIY60640.1__F-del_DSCav1_mut3
  source 1..1545: mol_type = other RNA
atggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataa

SEQ ID NO: 15793 - RNA, 1545 nt, synthetic construct
  misc_feature 1..1545: note = derived and/or modified CDS sequence (opt11) from HRSV(Memphis-37)__AIY60640.1__F-del_DSCav1_mut3
  source 1..1545: mol_type = other RNA
atggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctga

SEQ ID NO: 15794 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut3 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15795 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut3 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15796 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut3 (opt2)
  source 1..1821: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15797 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut3 (opt3)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15798 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut3 (opt4)
  source 1..1821: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15799 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut3 (opt5)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15800 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut3 (opt6)
  source 1..1821: mol_type = other RNA
gggagagtcccgcagtcggcgtccagcggctctgcttgttcgtgtgtgtgtcgttgcaggccttattcaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15801 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut3 (opt11)
  source 1..1821: mol_type = other RNA
gggagagtcccgcagtcggcgtccagcggctctgcttgttcgtgtgtgtgtcgttgcaggccttattcaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15802 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut3 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15803 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut3 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15804 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut3 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15805 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut3 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15806 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut3 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15807 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut3 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15808 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut3 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15809 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut3 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15810 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut3 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15811 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut3 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15812 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut3 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15813 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut3 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15814 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut3 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15815 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut3 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15816 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut3 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15817 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut3 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15818 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut3 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15819 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut3 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15820 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut3 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15821 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut3 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15822 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut3 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15823 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut3 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15824 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut3 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15825 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut3 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15826 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut3 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15827 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut3 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15828 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut3 (opt2)
  source 1..1813: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15829 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut3 (opt3)
  source 1..1813: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15830 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut3 (opt4)
  source 1..1813: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15831 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut3 (opt5)
  source 1..1813: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15832 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut3 (opt6)
  source 1..1813: mol_type = other RNA
gggagactttcccattctgtagcagaatttggtgttgcctgtggtcttggtcccgcggagaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15833 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut3 (opt11)
  source 1..1813: mol_type = other RNA
gggagactttcccattctgtagcagaatttggtgttgcctgtggtcttggtcccgcggagaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15834 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut3 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15835 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut3 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15836 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut3 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15837 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut3 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15838 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut3 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15839 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut3 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15840 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut3 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15841 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut3 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15842 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut3 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15843 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut3 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15844 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut3 (opt2)
  source 1..1814: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15845 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut3 (opt3)
  source 1..1814: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15846 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut3 (opt4)
  source 1..1814: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15847 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut3 (opt5)
  source 1..1814: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15848 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut3 (opt6)
  source 1..1814: mol_type = other RNA
gggagagcctctgctggagtccggggagtggcgttggctgctagagcgaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15849 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut3 (opt11)
  source 1..1814: mol_type = other RNA
gggagagcctctgctggagtccggggagtggcgttggctgctagagcgaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15850 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut3 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15851 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut3 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15852 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut3 (opt2)
  source 1..1834: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15853 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut3 (opt3)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15854 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut3 (opt4)
  source 1..1834: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15855 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut3 (opt5)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15856 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut3 (opt6)
  source 1..1834: mol_type = other RNA
gggagagtcccgcagtcggcgtccagcggctctgcttgttcgtgtgtgtgtcgttgcaggccttattcaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15857 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut3 (opt11)
  source 1..1834: mol_type = other RNA
gggagagtcccgcagtcggcgtccagcggctctgcttgttcgtgtgtgtgtcgttgcaggccttattcaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15858 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut3 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15859 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut3 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15860 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut3 (opt2)
  source 1..1885: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15861 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut3 (opt3)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15862 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut3 (opt4)
  source 1..1885: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15863 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut3 (opt5)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15864 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut3 (opt6)
  source 1..1885: mol_type = other RNA
gggagagtcccgcagtcggcgtccagcggctctgcttgttcgtgtgtgtgtcgttgcaggccttattcaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15865 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut3 (opt11)
  source 1..1885: mol_type = other RNA
gggagagtcccgcagtcggcgtccagcggctctgcttgttcgtgtgtgtgtcgttgcaggccttattcaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15866 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut3 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15867 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut3 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15868 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut3 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15869 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut3 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15870 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut3 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15871 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut3 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15872 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut3 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15873 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut3 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15874 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut3 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15875 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut3 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15876 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut3 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15877 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut3 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15878 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut3 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15879 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut3 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15880 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut3 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15881 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut3 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15882 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut3 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15883 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut3 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15884 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut3 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15885 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut3 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15886 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut3 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15887 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut3 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15888 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut3 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15889 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut3 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15890 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut3 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15891 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut3 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15892 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut3 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15893 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut3 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15894 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut3 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15895 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut3 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15896 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut3 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15897 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut3 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15898 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut3 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15899 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut3 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15900 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut3 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15901 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut3 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15902 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut3 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15903 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut3 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15904 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut3 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15905 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut3 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15906 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut3 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15907 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut3 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15908 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut3 (opt2)
  source 1..1834: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15909 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut3 (opt3)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15910 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut3 (opt4)
  source 1..1834: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15911 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut3 (opt5)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15912 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut3 (opt6)
  source 1..1834: mol_type = other RNA
gggagagcggctcggccattttgtcccagtcagtccggaggctgcggctgcagaagtaccgcctgcggagtaactgcaaagaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15913 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut3 (opt11)
  source 1..1834: mol_type = other RNA
gggagagcggctcggccattttgtcccagtcagtccggaggctgcggctgcagaagtaccgcctgcggagtaactgcaaagaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15914 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut3 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15915 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut3 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15916 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut3 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15917 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut3 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15918 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut3 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15919 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut3 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15920 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut3 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15921 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut3 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15922 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut3 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15923 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut3 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15924 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut3 (opt2)
  source 1..1898: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15925 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut3 (opt3)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15926 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut3 (opt4)
  source 1..1898: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15927 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut3 (opt5)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15928 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut3 (opt6)
  source 1..1898: mol_type = other RNA
gggagagcggctcggccattttgtcccagtcagtccggaggctgcggctgcagaagtaccgcctgcggagtaactgcaaagaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15929 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut3 (opt11)
  source 1..1898: mol_type = other RNA
gggagagcggctcggccattttgtcccagtcagtccggaggctgcggctgcagaagtaccgcctgcggagtaactgcaaagaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15930 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut3 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15931 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut3 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15932 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut3 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15933 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut3 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15934 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut3 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15935 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut3 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15936 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut3 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15937 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut3 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15938 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut3 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15939 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut3 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15940 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut3 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15941 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut3 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15942 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut3 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15943 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut3 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15944 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut3 (opt6)
  source 1..1897: mol_type = other RNA
gggagagtcccgcagtcggcgtccagcggctctgcttgttcgtgtgtgtgtcgttgcaggccttattcaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15945 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut3 (opt11)
  source 1..1897: mol_type = other RNA
gggagagtcccgcagtcggcgtccagcggctctgcttgttcgtgtgtgtgtcgttgcaggccttattcaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15946 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut3 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15947 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut3 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15948 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut3 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15949 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut3 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15950 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut3 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15951 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut3 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15952 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut3 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15953 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut3 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15954 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut3 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15955 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut3 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15956 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut3 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15957 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut3 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15958 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut3 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15959 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut3 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15960 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut3 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15961 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut3 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15962 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut3 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15963 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut3 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15964 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut3 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15965 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut3 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15966 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut3 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15967 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut3 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15968 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut3 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15969 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut3 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15970 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut3 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15971 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut3 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15972 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut3 (opt2)
  source 1..1826: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15973 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut3 (opt3)
  source 1..1826: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15974 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut3 (opt4)
  source 1..1826: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15975 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut3 (opt5)
  source 1..1826: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15976 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut3 (opt6)
  source 1..1826: mol_type = other RNA
gggagactttcccattctgtagcagaatttggtgttgcctgtggtcttggtcccgcggagaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15977 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut3 (opt11)
  source 1..1826: mol_type = other RNA
gggagactttcccattctgtagcagaatttggtgttgcctgtggtcttggtcccgcggagaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15978 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut3 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15979 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut3 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15980 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut3 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15981 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut3 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15982 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut3 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15983 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut3 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15984 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut3 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15985 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut3 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15986 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut3 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15987 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut3 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15988 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut3 (opt2)
  source 1..1847: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15989 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut3 (opt3)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15990 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut3 (opt4)
  source 1..1847: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15991 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut3 (opt5)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15992 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut3 (opt6)
  source 1..1847: mol_type = other RNA
gggagagcggctcggccattttgtcccagtcagtccggaggctgcggctgcagaagtaccgcctgcggagtaactgcaaagaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15993 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut3 (opt11)
  source 1..1847: mol_type = other RNA
gggagagcggctcggccattttgtcccagtcagtccggaggctgcggctgcagaagtaccgcctgcggagtaactgcaaagaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15994 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut3 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15995 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut3 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15996 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut3 (opt2)
  source 1..1914: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15997 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut3 (opt3)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15998 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut3 (opt4)
  source 1..1914: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 15999 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut3 (opt5)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16000 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut3 (opt6)
  source 1..1914: mol_type = other RNA
gggagagcggctcggccattttgtcccagtcagtccggaggctgcggctgcagaagtaccgcctgcggagtaactgcaaagaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16001 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut3 (opt11)
  source 1..1914: mol_type = other RNA
gggagagcggctcggccattttgtcccagtcagtccggaggctgcggctgcagaagtaccgcctgcggagtaactgcaaagaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16002 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut3 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16003 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut3 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16004 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut3 (opt2)
  source 1..2130: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16005 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut3 (opt3)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16006 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut3 (opt4)
  source 1..2130: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16007 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut3 (opt5)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16008 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut3 (opt6)
  source 1..2130: mol_type = other RNA
gggagagcggctcggccattttgtcccagtcagtccggaggctgcggctgcagaagtaccgcctgcggagtaactgcaaagaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16009 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut3 (opt11)
  source 1..2130: mol_type = other RNA
gggagagcggctcggccattttgtcccagtcagtccggaggctgcggctgcagaagtaccgcctgcggagtaactgcaaagaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16010 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut3 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16011 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut3 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16012 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut3 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16013 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut3 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16014 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut3 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16015 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut3 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16016 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut3 (opt6)
  source 1..1910: mol_type = other RNA
gggagagcggctcggccattttgtcccagtcagtccggaggctgcggctgcagaagtaccgcctgcggagtaactgcaaagaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16017 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut3 (opt11)
  source 1..1910: mol_type = other RNA
gggagagcggctcggccattttgtcccagtcagtccggaggctgcggctgcagaagtaccgcctgcggagtaactgcaaagaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16018 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut3 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16019 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut3 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16020 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut3 (opt2)
  source 1..1901: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16021 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut3 (opt3)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16022 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut3 (opt4)
  source 1..1901: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16023 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut3 (opt5)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16024 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut3 (opt6)
  source 1..1901: mol_type = other RNA
gggagagtcccgcagtcggcgtccagcggctctgcttgttcgtgtgtgtgtcgttgcaggccttattcaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16025 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut3 (opt11)
  source 1..1901: mol_type = other RNA
gggagagtcccgcagtcggcgtccagcggctctgcttgttcgtgtgtgtgtcgttgcaggccttattcaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16026 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut3 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16027 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut3 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16028 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut3 (opt2)
  source 1..2117: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16029 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut3 (opt3)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16030 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut3 (opt4)
  source 1..2117: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16031 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut3 (opt5)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16032 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut3 (opt6)
  source 1..2117: mol_type = other RNA
gggagagtcccgcagtcggcgtccagcggctctgcttgttcgtgtgtgtgtcgttgcaggccttattcaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16033 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut3 (opt11)
  source 1..2117: mol_type = other RNA
gggagagtcccgcagtcggcgtccagcggctctgcttgttcgtgtgtgtgtcgttgcaggccttattcaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16034 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut3 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16035 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut3 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16036 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut3 (opt2)
  source 1..1893: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16037 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut3 (opt3)
  source 1..1893: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16038 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut3 (opt4)
  source 1..1893: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16039 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut3 (opt5)
  source 1..1893: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16040 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut3 (opt6)
  source 1..1893: mol_type = other RNA
gggagactttcccattctgtagcagaatttggtgttgcctgtggtcttggtcccgcggagaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16041 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut3 (opt11)
  source 1..1893: mol_type = other RNA
gggagactttcccattctgtagcagaatttggtgttgcctgtggtcttggtcccgcggagaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16042 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut3 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16043 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut3 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16044 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut3 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16045 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut3 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16046 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut3 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16047 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut3 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16048 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut3 (opt6)
  source 1..1889: mol_type = other RNA
gggagactttcccattctgtagcagaatttggtgttgcctgtggtcttggtcccgcggagaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16049 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut3 (opt11)
  source 1..1889: mol_type = other RNA
gggagactttcccattctgtagcagaatttggtgttgcctgtggtcttggtcccgcggagaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16050 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut3 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16051 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut3 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16052 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut3 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16053 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut3 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16054 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut3 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16055 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut3 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16056 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut3 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16057 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut3 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16058 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut3 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16059 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut3 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16060 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut3 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16061 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut3 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16062 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut3 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16063 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut3 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16064 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut3 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16065 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut3 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16066 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut3 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16067 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut3 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16068 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut3 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16069 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut3 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16070 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut3 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16071 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut3 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16072 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut3 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16073 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut3 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16074 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut3 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16075 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut3 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16076 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut3 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16077 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut3 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16078 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut3 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16079 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut3 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16080 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut3 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16081 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut3 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16082 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut3 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16083 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut3 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16084 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut3 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16085 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut3 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16086 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut3 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16087 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut3 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16088 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut3 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16089 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut3 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16090 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut3 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16091 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut3 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16092 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut3 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16093 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut3 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16094 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut3 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16095 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut3 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16096 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut3 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16097 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut3 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16098 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut3 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16099 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut3 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16100 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut3 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16101 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut3 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16102 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut3 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16103 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut3 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16104 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut3 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16105 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut3 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16106 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut3 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16107 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut3 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16108 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut3 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16109 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut3 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16110 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut3 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16111 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut3 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16112 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut3 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16113 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut3 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16114 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut3 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16115 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut3 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16116 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut3 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16117 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut3 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16118 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut3 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16119 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut3 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16120 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut3 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16121 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut3 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16122 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut3 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16123 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut3 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16124 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut3 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16125 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut3 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16126 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut3 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16127 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut3 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16128 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut3 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16129 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut3 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16130 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut3 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16131 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut3 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16132 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut3 (opt2)
  source 1..1931: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16133 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut3 (opt3)
  source 1..1931: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16134 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut3 (opt4)
  source 1..1931: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16135 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut3 (opt5)
  source 1..1931: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16136 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut3 (opt6)
  source 1..1931: mol_type = other RNA
gggagaggcgctgcctacggaggtggcagccatctccttctcggcatcaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16137 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut3 (opt11)
  source 1..1931: mol_type = other RNA
gggagaggcgctgcctacggaggtggcagccatctccttctcggcatcaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16138 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut3 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16139 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut3 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16140 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut3 (opt2)
  source 1..1927: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16141 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut3 (opt3)
  source 1..1927: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16142 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut3 (opt4)
  source 1..1927: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16143 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut3 (opt5)
  source 1..1927: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16144 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut3 (opt6)
  source 1..1927: mol_type = other RNA
ggggcgctgcctacggaggtggcagccatctccttctcggcatcaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16145 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut3 (opt11)
  source 1..1927: mol_type = other RNA
ggggcgctgcctacggaggtggcagccatctccttctcggcatcaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16146 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut3 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16147 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut3 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatctgcagcggcatcgcggtgtgcaaggtgctgcacctcgagggcgaggtcaacaagatcaagaacgccctgctgtccaccaacaaggccgtggtgagcctctccaacggggtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggcgtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcctacgtggtgcagctccccctgtacggggtcatcgacaccccctgctggaagctgcacacgagccccctctgcaccaccaacaccaaggagggctccaacatctgcctgacgcgcaccgaccgggggtggtactgcgacaacgcgggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaaccggggcatcatcaagaccttctccaacgggtgcgactacgtcagcaacaagggcgtggacaccgtgtccgtcggcaacacgctctactgcgtgaacaagcaggaggggcagagcctgtacgtgaagggcgagcccatcatcaacttctacgacccgctggtcttccccagcgacgagttcgacgcctccatcagccaggtgaacgagaagatcaaccagtccctcgcgttcatccgcaagagcgacgagctgctgcacaacgtgaacgtcgggaagtccaccaccaacatcatgatcaccaccatcatcatcgtgatcatcgtgatcctcctgctgctcatcgccgtcggcctgttcctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16148 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut3 (opt2)
  source 1..1762: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16149 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut3 (opt3)
  source 1..1762: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatctgtagcggaattgccgtgtgcaaggtcttgcacctcgagggcgaggtgaataaaatcaagaacgctctgctgagtaccaataaagccgttgtgtccctctctaacggtgtcagcgtgttaacgttcaaggtactggatcttaagaattacattgacaaacaattgctgccaatcctaaacaagcagtcctgttcaataccgaatattgaaactgttatcgagtttcagcagaaaaacaataggctcctggaaattacccgggagttcagtgtgaacgcgggggtcacaactcccgtgagcacctatatgcttacaaattctgagctgttgtccctcatcaacgatatgcctatcaccaacgaccaaaagaaactgatgtcaaataacgtgcagattgtccgccagcagagctacagtataatgtgcatcattaaggaagaggttttagcatatgtggtacaactgccactctacggagtgatcgatacgccctgttggaaacttcatacttctcctctgtgcacaaccaatactaaggaaggctccaacatatgtttgacacgaaccgaccgtggctggtactgcgataatgccgggagcgtctcgtttttcccacaggctgagacgtgtaaggtgcagtctaacagagttttctgcgacaccatgaactccctaacactgccctcagaagtgaatctctgcaatattgatatcttcaaccctaaatatgactgtaagatcatgacaagtaaaaccgatgtcagctcctctgtgattacaagcctgggagccatcgtatcatgctacggtaagactaaatgtaccgcaagtaataagaacaggggcattataaagacattttccaatgggtgcgactatgttagcaacaaaggagtggacaccgtctctgtgggcaatactctttactgtgtcaacaagcaagagggtcagtcactgtatgtgaaaggggagccaatcattaacttctacgatccgttggtttttcccagtgacgaatttgatgctagcatctcccaggtgaatgagaagatcaaccagtctctcgcctttattcggaaatcggacgaactgttacacaatgtaaacgtcggaaagagcacgacaaatataatgatcaccactattatcattgtgatcatagttatcctgctactcctgattgcggtgggccttttcttgtattgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16150 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut3 (opt4)
  source 1..1762: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16151 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut3 (opt5)
  source 1..1762: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatctgttccggcattgcggtctgcaaggtgctccacctggagggggaggttaataaaatcaagaacgcccttctgagcacaaataaagctgtggtctctctctccaacggagtgagcgttctgaccttcaaggtgcttgatctgaagaattacattgacaaacaactcctgccgatcctgaacaagcagtcttgttccattcccaatatcgaaacagtcatcgagtttcagcagaaaaacaatcggctcctggaaattacccgcgagttcagcgtgaacgccggcgtgacgacacctgtctctacctatatgcttacaaattccgagctgctcagcctgatcaacgatatgcccattaccaacgaccaaaagaaacttatgtccaataacgttcagatcgtgagacagcagtcttacagcattatgtgcatcatcaaggaagaggtgctggcttatgtcgtgcaactccctctgtacggcgttattgataccccctgttggaaactgcatacatcccctctctgcacgaccaatacaaaggaagggagcaacatctgtctgacccggacagaccgcggatggtactgcgataatgccggctctgtgtcctttttcccgcaggcggagacctgtaaggtccagagcaacagagtgttttgcgacacgatgaactctcttacactgcccagcgaagttaatctctgcaatattgatatcttcaaccctaaatatgactgtaagattatgacctccaaaaccgatgtgtctagctccgtcatcacaagcctgggggccatcgtgtcttgctacggaaagaccaaatgtacagcttccaataagaaccggggcattatcaagacgtttagcaatgggtgcgactatgtctctaacaaaggagtggacaccgtttccgtgggcaatacactttactgtgtcaacaagcaagagggccagagcctgtatgtgaaaggggagcccattatcaacttctacgatcctctcgtttttccctccgacgagttcgatgcctctattagccaggtgaatgaaaagatcaaccagtccctggcttttattcgcaaatctgacgaactgctccacaatgtcaacgtgggaaagagcaccacaaatatcatgatcaccacgattatcattgtgatcattgttatcctgcttctgctcatcgccgtcggcctgttcctgtattgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16152 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut3 (opt6)
  source 1..1762: mol_type = other RNA
gggagaaagcttaccatggaactacccatcctaaaaacaaatgccataaccacaatactcgccgctgtaacactatgtttcgctagttcacaaaacattacagaagaattttaccaatccacatgctcagcagtatcaaaaggatacctaggtgcactaagaacaggatggtacacaagcgtaattacaatagaattatccaatattaaagaaataaaatgtaacggcactgacgctaaagtaaaattaatcaaacaagaactagacaaatacaaaaacgcagtaacagacctacaattactcatgcaatccacacccgcagcaggatcaggctcagccatatgctcaggtatagcagtatgcaaagtactccaccttgaaggagaagtaaacaaaataaaaaacgcattactatcaacaaacaaagcagtagtatcactatcaaacggagtctctgtcttaacctttaaagtattagatttaaaaaactacatagacaaacaactattaccaattctaaataaacaatcatgttctataccaaatatagaaacagtaatagaatttcaacaaaaaaacaaccgattactagaaatcacaagagaattttctgtcaacgccggcgtaaccaccccagtctcaacatatatgctaacaaatagtgaactcttatccttaataaacgacatgccaataacaaatgaccaaaaaaaattaatgtccaataacgtacaaatagtcagacaacagtcatactcaataatgtgtatcatcaaagaagaagtattagcatacgtagttcaactacccctatacggcgtaatagacacaccatgttggaaactacacacatcacccttatgcacaaccaataccaaagaaggatctaacatatgcctaaccagaacagacagaggctggtactgcgacaacgcaggttcagtctcattcttcccacaagccgaaacatgcaaagtccaatccaacagagtattttgcgacactatgaactcactaactctaccttcagaagtcaacctttgtaacatagacatatttaacccaaaatacgattgtaaaataatgaccagcaaaacagacgtctcatcaagcgtaataacatcacttggcgcaatagtctcctgctacggaaaaacaaaatgcacagcatccaacaaaaacagaggcatcataaaaaccttctccaacggctgcgactatgtaagcaacaaaggtgtcgatacagtatcagtaggaaacacactatactgcgtaaacaaacaagaaggacaatcactctacgtaaaaggtgaaccaatcataaacttctacgacccattagttttcccatcagacgaatttgatgcctccatatcacaagtaaatgaaaaaataaatcaatccctagcattcatacgaaaatctgatgaattacttcacaatgtcaacgtcggaaaatcaaccactaacataatgataacaacaattataatagtaataatagtaatactcctactattaatagccgtcggtcttttcctatactgcaaagcacgataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16153 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut3 (opt11)
  source 1..1762: mol_type = other RNA
gggagaaagcttaccatggaactacccatcctcaaaaccaacgccatcaccacaatcctagctgccgtcaccctatgcttcgcaagcagccaaaacatcacagaagaattttaccaatcaacctgctccgccgtctccaaagggtacctaggtgccctccgcaccggctggtacacgtctgtcataaccatcgaactctccaacatcaaagaaatcaaatgtaacggaacagacgcaaaagtcaaactaatcaaacaagaactagacaaatacaaaaacgccgtaaccgacctccaactgctcatgcaatccacccccgctgccggctccgggagcgcaatctgctctggaatcgccgtatgcaaagtcctccacctcgaaggagaagtaaacaaaatcaaaaacgcgctcctcagtaccaacaaagccgtcgtctctctatcaaacggcgtatcggtcctcaccttcaaagtcctcgacctaaagaactacatagacaaacaactcctccccatcctaaacaaacaatcctgctcaatcccaaacatcgaaaccgtgatcgagttccaacagaaaaacaaccgcctactcgaaatcacccgagagttctcagtcaacgcaggagtcaccacccccgtctcaacatacatgcttaccaacagcgaactcctatccctcatcaacgacatgccaatcacaaacgaccaaaagaaactcatgagcaacaacgtccagatcgtaagacaacaaagctacagcatcatgtgcatcatcaaagaagaagtactagcatacgtcgtccaactccccctctacggcgtcatcgacaccccctgctggaaactccacacctcacccctctgcacaaccaacaccaaagaaggctccaatatctgcctcacacgcaccgaccgcggctggtactgcgacaacgccggctccgtctccttcttccctcaagccgaaacctgcaaagtccagtccaacagagtcttctgcgacaccatgaactccctaacacttccatcagaagtcaacctttgtaacatcgacatcttcaatcccaaatacgactgtaaaataatgacctcaaaaactgacgtgtcaagctcagttatcacctccctaggggccatcgtctcctgctacggcaaaacaaaatgcaccgcatccaacaaaaatcgcggaatcatcaaaacattctccaacggatgcgactacgtctcaaacaagggagtagataccgtaagcgttggcaacaccctctactgcgtaaacaaacaagaaggccaatcactctacgtcaaaggcgaacccataatcaacttctacgaccccctcgtcttcccttccgatgagttcgacgccagcatctcccaagtcaacgagaaaataaaccagtcactcgcattcatccgcaaaagcgacgaactcctccacaacgtaaacgtaggcaaatccacaaccaatatcatgataaccacaatcatcatcgtgatcatcgtcatcctcctcctcctcatagctgtcggactcttcctctactgtaaagcacgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16154 - protein, 535 aa, synthetic construct
  REGION 1..535: note = derived and/or modified protein sequence (artificial) from HRSV(Memphis-37)__AIY60640.1__F_DSCav1_mut4
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAAGSGSAICSGIAVCKVLHLEGEVNKIKNALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNIDIFNPKYDCKIMTSKTDVSSSVITSLGAIVSCYGKTKCTASNKNRGIIKTFSNGCDYVSNKGVDTVSVGNTLYCVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 16155 - RNA, 1608 nt, synthetic construct
  misc_feature 1..1608: note = derived and/or modified CDS sequence (opt1) from HRSV(Memphis-37)__AIY60640.1__F_DSCav1_mut4
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 16156 - RNA, 1608 nt, synthetic construct
  misc_feature 1..1608: note = derived and/or modified CDS sequence (opt1) from HRSV(Memphis-37)__AIY60640.1__F_DSCav1_mut4
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactga

SEQ ID NO: 16157 - RNA, 1608 nt, synthetic construct
  misc_feature 1..1608: note = derived and/or modified CDS sequence (opt2) from HRSV(Memphis-37)__AIY60640.1__F_DSCav1_mut4
  source 1..1608: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 16158 - RNA, 1608 nt, synthetic construct
  misc_feature 1..1608: note = derived and/or modified CDS sequence (opt3) from HRSV(Memphis-37)__AIY60640.1__F_DSCav1_mut4
  source 1..1608: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattga

SEQ ID NO: 16159 - RNA, 1608 nt, synthetic construct
  misc_feature 1..1608: note = derived and/or modified CDS sequence (opt4) from HRSV(Memphis-37)__AIY60640.1__F_DSCav1_mut4
  source 1..1608: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 16160 - RNA, 1608 nt, synthetic construct
  misc_feature 1..1608: note = derived and/or modified CDS sequence (opt5) from HRSV(Memphis-37)__AIY60640.1__F_DSCav1_mut4
  source 1..1608: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattga

SEQ ID NO: 16161 - RNA, 1608 nt, synthetic construct
  misc_feature 1..1608: note = derived and/or modified CDS sequence (opt6) from HRSV(Memphis-37)__AIY60640.1__F_DSCav1_mut4
  source 1..1608: mol_type = other RNA
atggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaa

SEQ ID NO: 16162 - RNA, 1608 nt, synthetic construct
  misc_feature 1..1608: note = derived and/or modified CDS sequence (opt11) from HRSV(Memphis-37)__AIY60640.1__F_DSCav1_mut4
  source 1..1608: mol_type = other RNA
atggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactga

SEQ ID NO: 16163 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut4 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16164 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut4 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16165 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut4 (opt2)
  source 1..1884: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16166 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut4 (opt3)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16167 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut4 (opt4)
  source 1..1884: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16168 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut4 (opt5)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16169 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut4 (opt6)
  source 1..1884: mol_type = other RNA
gggagagtcccgcagtcggcgtccagcggctctgcttgttcgtgtgtgtgtcgttgcaggccttattcaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16170 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut4 (opt11)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16171 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut4 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16172 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut4 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16173 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut4 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16174 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut4 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16175 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut4 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16176 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut4 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16177 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut4 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16178 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut4 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16179 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut4 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16180 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut4 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16181 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut4 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16182 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut4 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16183 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut4 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16184 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut4 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16185 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut4 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16186 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut4 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16187 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut4 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16188 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut4 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16189 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut4 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16190 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut4 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16191 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut4 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16192 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut4 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16193 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut4 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16194 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut4 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16195 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut4 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16196 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut4 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16197 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut4 (opt2)
  source 1..1876: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16198 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut4 (opt3)
  source 1..1876: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16199 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut4 (opt4)
  source 1..1876: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16200 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut4 (opt5)
  source 1..1876: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16201 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut4 (opt6)
  source 1..1876: mol_type = other RNA
gggagactttcccattctgtagcagaatttggtgttgcctgtggtcttggtcccgcggagaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16202 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut4 (opt11)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16203 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut4 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16204 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut4 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16205 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut4 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16206 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut4 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16207 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut4 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16208 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut4 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16209 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut4 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16210 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut4 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16211 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut4 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16212 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut4 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16213 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut4 (opt2)
  source 1..1877: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16214 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut4 (opt3)
  source 1..1877: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16215 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut4 (opt4)
  source 1..1877: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16216 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut4 (opt5)
  source 1..1877: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16217 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut4 (opt6)
  source 1..1877: mol_type = other RNA
gggagagcctctgctggagtccggggagtggcgttggctgctagagcgaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16218 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut4 (opt11)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16219 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut4 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16220 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut4 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16221 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut4 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16222 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut4 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16223 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut4 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16224 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut4 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16225 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut4 (opt6)
  source 1..1897: mol_type = other RNA
gggagagtcccgcagtcggcgtccagcggctctgcttgttcgtgtgtgtgtcgttgcaggccttattcaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16226 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut4 (opt11)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16227 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut4 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16228 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut4 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16229 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut4 (opt2)
  source 1..1948: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16230 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut4 (opt3)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16231 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut4 (opt4)
  source 1..1948: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16232 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut4 (opt5)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16233 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut4 (opt6)
  source 1..1948: mol_type = other RNA
gggagagtcccgcagtcggcgtccagcggctctgcttgttcgtgtgtgtgtcgttgcaggccttattcaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16234 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut4 (opt11)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16235 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut4 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16236 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut4 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16237 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut4 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16238 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut4 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16239 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut4 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16240 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut4 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16241 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut4 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16242 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut4 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16243 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut4 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16244 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut4 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16245 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut4 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16246 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut4 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16247 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut4 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16248 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut4 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16249 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut4 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16250 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut4 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16251 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut4 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16252 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut4 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16253 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut4 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16254 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut4 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16255 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut4 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16256 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut4 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16257 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut4 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16258 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut4 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16259 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut4 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16260 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut4 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16261 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut4 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16262 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut4 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16263 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut4 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16264 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut4 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16265 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut4 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16266 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut4 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16267 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut4 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16268 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut4 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16269 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut4 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16270 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut4 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16271 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut4 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16272 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut4 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16273 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut4 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16274 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut4 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16275 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut4 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16276 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut4 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16277 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut4 (opt2)
  source 1..1897: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16278 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut4 (opt3)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16279 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut4 (opt4)
  source 1..1897: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16280 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut4 (opt5)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16281 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut4 (opt6)
  source 1..1897: mol_type = other RNA
gggagagcggctcggccattttgtcccagtcagtccggaggctgcggctgcagaagtaccgcctgcggagtaactgcaaagaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16282 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut4 (opt11)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16283 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut4 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16284 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut4 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16285 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut4 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16286 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut4 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16287 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut4 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16288 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut4 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16289 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut4 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16290 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut4 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16291 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut4 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16292 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut4 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16293 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut4 (opt2)
  source 1..1961: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16294 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut4 (opt3)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16295 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut4 (opt4)
  source 1..1961: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16296 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut4 (opt5)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16297 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut4 (opt6)
  source 1..1961: mol_type = other RNA
gggagagcggctcggccattttgtcccagtcagtccggaggctgcggctgcagaagtaccgcctgcggagtaactgcaaagaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16298 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut4 (opt11)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16299 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut4 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16300 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut4 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16301 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut4 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16302 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut4 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16303 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut4 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16304 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut4 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16305 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut4 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16306 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut4 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16307 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut4 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16308 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut4 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16309 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut4 (opt2)
  source 1..1960: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16310 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut4 (opt3)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16311 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut4 (opt4)
  source 1..1960: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16312 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut4 (opt5)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16313 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut4 (opt6)
  source 1..1960: mol_type = other RNA
gggagagtcccgcagtcggcgtccagcggctctgcttgttcgtgtgtgtgtcgttgcaggccttattcaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16314 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut4 (opt11)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16315 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut4 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16316 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut4 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16317 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut4 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16318 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut4 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16319 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut4 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16320 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut4 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16321 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut4 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16322 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut4 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16323 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut4 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16324 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut4 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16325 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut4 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16326 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut4 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16327 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut4 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16328 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut4 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16329 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut4 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16330 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut4 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16331 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut4 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16332 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut4 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16333 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut4 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16334 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut4 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16335 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut4 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16336 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut4 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16337 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut4 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16338 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut4 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16339 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut4 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16340 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut4 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16341 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut4 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16342 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut4 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16343 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut4 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16344 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut4 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16345 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut4 (opt6)
  source 1..1889: mol_type = other RNA
gggagactttcccattctgtagcagaatttggtgttgcctgtggtcttggtcccgcggagaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16346 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut4 (opt11)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16347 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut4 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16348 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut4 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16349 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut4 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16350 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut4 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16351 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut4 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16352 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut4 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16353 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut4 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16354 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut4 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16355 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut4 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16356 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut4 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16357 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut4 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16358 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut4 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16359 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut4 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16360 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut4 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16361 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut4 (opt6)
  source 1..1910: mol_type = other RNA
gggagagcggctcggccattttgtcccagtcagtccggaggctgcggctgcagaagtaccgcctgcggagtaactgcaaagaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16362 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut4 (opt11)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16363 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut4 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16364 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut4 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16365 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut4 (opt2)
  source 1..1977: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16366 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut4 (opt3)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16367 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut4 (opt4)
  source 1..1977: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16368 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut4 (opt5)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16369 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut4 (opt6)
  source 1..1977: mol_type = other RNA
gggagagcggctcggccattttgtcccagtcagtccggaggctgcggctgcagaagtaccgcctgcggagtaactgcaaagaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16370 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut4 (opt11)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16371 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut4 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16372 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut4 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16373 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut4 (opt2)
  source 1..2193: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16374 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut4 (opt3)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16375 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut4 (opt4)
  source 1..2193: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16376 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut4 (opt5)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16377 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut4 (opt6)
  source 1..2193: mol_type = other RNA
gggagagcggctcggccattttgtcccagtcagtccggaggctgcggctgcagaagtaccgcctgcggagtaactgcaaagaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16378 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut4 (opt11)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16379 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut4 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16380 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut4 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16381 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut4 (opt2)
  source 1..1973: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16382 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut4 (opt3)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16383 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut4 (opt4)
  source 1..1973: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16384 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut4 (opt5)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16385 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut4 (opt6)
  source 1..1973: mol_type = other RNA
gggagagcggctcggccattttgtcccagtcagtccggaggctgcggctgcagaagtaccgcctgcggagtaactgcaaagaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16386 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut4 (opt11)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16387 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut4 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16388 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut4 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16389 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut4 (opt2)
  source 1..1964: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16390 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut4 (opt3)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16391 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut4 (opt4)
  source 1..1964: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16392 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut4 (opt5)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16393 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut4 (opt6)
  source 1..1964: mol_type = other RNA
gggagagtcccgcagtcggcgtccagcggctctgcttgttcgtgtgtgtgtcgttgcaggccttattcaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16394 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut4 (opt11)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16395 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut4 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16396 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut4 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16397 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut4 (opt2)
  source 1..2180: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16398 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut4 (opt3)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16399 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut4 (opt4)
  source 1..2180: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16400 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut4 (opt5)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16401 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut4 (opt6)
  source 1..2180: mol_type = other RNA
gggagagtcccgcagtcggcgtccagcggctctgcttgttcgtgtgtgtgtcgttgcaggccttattcaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16402 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut4 (opt11)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16403 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut4 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16404 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut4 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16405 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut4 (opt2)
  source 1..1956: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16406 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut4 (opt3)
  source 1..1956: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16407 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut4 (opt4)
  source 1..1956: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16408 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut4 (opt5)
  source 1..1956: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16409 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut4 (opt6)
  source 1..1956: mol_type = other RNA
gggagactttcccattctgtagcagaatttggtgttgcctgtggtcttggtcccgcggagaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16410 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut4 (opt11)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16411 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut4 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16412 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut4 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16413 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut4 (opt2)
  source 1..1952: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16414 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut4 (opt3)
  source 1..1952: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16415 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut4 (opt4)
  source 1..1952: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16416 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut4 (opt5)
  source 1..1952: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16417 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut4 (opt6)
  source 1..1952: mol_type = other RNA
gggagactttcccattctgtagcagaatttggtgttgcctgtggtcttggtcccgcggagaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16418 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut4 (opt11)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16419 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut4 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16420 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut4 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16421 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut4 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16422 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut4 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16423 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut4 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16424 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut4 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16425 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut4 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16426 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut4 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16427 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut4 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16428 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut4 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16429 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut4 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16430 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut4 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16431 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut4 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16432 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut4 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16433 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut4 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16434 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut4 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16435 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut4 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16436 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut4 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16437 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut4 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16438 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut4 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16439 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut4 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16440 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut4 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16441 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut4 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16442 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut4 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16443 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut4 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16444 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut4 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16445 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut4 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16446 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut4 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16447 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut4 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16448 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut4 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16449 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut4 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16450 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut4 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16451 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut4 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16452 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut4 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16453 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut4 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16454 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut4 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16455 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut4 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccgccggcagcggcagcgccatctgcagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16456 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut4 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagctgctgatgcagtctacccctgccgctggcagcgggtccgccatttgtagcggaatcgcggtctgcaaggtgctccacctggagggcgaagttaacaaaattaagaatgcccttctgtctacaaacaaagctgtggtctccctcagcaatggggtgtctgttctgaccttcaaggtgcttgacctgaagaactacatcgataaacaactcctgccgattctgaataagcagtcctgtagcatctctaacattgagacagtcatcgaatttcagcagaaaaataaccggctcctggagatcacccgcgagttctccgtgaatgccggagtgacgacacccgtcagcacctatatgcttacaaactccgaactgctctctctgattaacgacatgcctatcaccaatgatcaaaagaaacttatgagcaacaatgttcagattgtgagacagcagtcctacagcatcatgtgcattatcaaggaggaagtgctggcttatgtcgtgcaactccccctgtacggcgttatcgacaccccttgttggaaactgcatacatctcccctctgcacgaccaacacaaaggagggctccaatatttgtctgacccggacagatcgcgggtggtactgcgacaacgccggaagcgtgagctttttccctcaggcggaaacctgtaaggtccagtctaatagagtgttttgcgatacgatgaactccagaacactgccgtctgaggttaatctctgcaacatcgacattttcaatcccaaatatgattgtaagatcatgaccagcaaaaccgacgtgtccagctctgtcattacatccctgggcgccatcgtgagctgctacgggaagaccaaatgtacagcttctaacaagaatcggggaatcattaagacgttttccaacggctgcgattatgtcagcaataaaggggtggacaccgtttccgtgggaaacacactttactgtgtcaacaagcaagagggcaaatctctgtatgtgaagggcgaacctatcattaatttctacgaccccctcgtttttcctagcgatgagttcgacgcctccatctctcaggtgaacgaaaagattaatcagagcctggcttttatccgcaagtccgatgagctgctccacaacgtcaatgtggggaaaagcaccacaaacattatgatcaccacgatcattatcgtgattatcgttattctgcttctgctcatcgccgtcggactgttcctgtattgcaaagccagatctacccccgtgacactttccaaggaccagctcagcggcatcaataacattgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16457 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut4 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaactcccaatcctaaaaacaaacgcaataacaacaatattagcagccgtaacactctgtttcgcctcatcccaaaacataacagaagaattttatcaatctacatgttccgccgtcagtaaaggatatctatcagccttaagaacaggctggtacacatcagtaatcaccatagaattatccaacataaaagaaaacaaatgcaatggcacagatgccaaagtaaaactaatcaaacaagaacttgataaatataaaaacgcagtaacagaattacaattattaatgcaaagcacaccagccgcaggatcaggatcagcaatatgttcaggaatagcagtctgtaaagtactacacttagaaggagaagtaaacaaaattaaaaacgcattactaagcaccaataaagcagtagtatcactatcaaacggcgtatccgtattaacgttcaaagtcctcgacctgaaaaactacatagataaacaactactaccaatactaaataaacaatcatgctcaatatcaaacatagaaactgttatcgaatttcaacagaaaaataaccgactactagaaatcaccagagaattttcagtaaacgcaggcgtcactacaccagtatccacatacatgctaaccaactcggaattactttccctcataaacgacatgccaataacaaacgaccaaaagaaacttatgtcaaacaacgttcaaatagtccgccaacaatcatactcaataatgtgtatcataaaagaagaagtcctagcatatgtcgtacaactaccattatacggagtaattgacacaccttgctggaaactacacacatccccactatgtacaacaaacactaaagaaggatcaaacatctgcctaaccagaacagacagaggctggtattgcgacaacgcaggatcagtatcattcttcccacaagcagaaacatgcaaagtacaatcaaacagagtcttctgcgacaccatgaacagcagaaccctcccatccgaagtaaacttatgcaacatcgatatcttcaacccaaaatacgactgtaaaataatgacatcaaaaacagacgtttcatcctcagtaataacatcattaggtgccatagtttcatgttacggaaaaaccaaatgtaccgcatcaaacaaaaacagaggcattattaaaacattctctaacggatgcgactatgtcagtaacaaaggagtagacacagtatcagtcggaaacacattatattgcgtaaataaacaagaaggaaaaagtctatacgtaaaaggagaaccaataataaacttttacgaccctctcgtattcccatcagacgaatttgatgcatccatatcacaagtcaacgaaaagataaaccaatccctagcattcataagaaaatcagacgaactactccataacgtaaacgtaggaaaaagcacaaccaatataatgataaccacaataatcatagtaataatagtcatattattacttttaattgcagtaggactctttctatactgcaaagcaagaagcacaccagtaacactaagcaaagaccaactatcaggcatcaacaatatcgccttttcaaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16458 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut4 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaaactcatcaagcaggagctggacaagtacaagaacgccgtcaccgagctgcagctcctgatgcagagcaccccggccgccgggtccggcagcgctatctgctccgggatcgcggtgtgcaaggtgctgcacctcgagggcgaggtcaacaagatcaagaatgccctgctgagcaccaacaaggccgtggtgtccctcagcaacggagtcagcgtgcttaccttcaaggtgctggacctcaagaactacatcgacaagcagctgctgcctatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgaactgctgtccctcatcaacgacatgcccatcaccaacgaccagaagaagctgatgagcaacaacgtgcagatcgtgcggcagcagtcctacagcatcatgtgcatcatcaaggaggaagtcctggcctacgtggtgcagctccctctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagagcaaccgcgtcttctgcgacactatgaacagcagaacgctcccgtccgaggtgaacctgtgcaacatagacatattcaaccccaagtacgactgcaagatcatgaccagcaagaccgacgtctccagctccgtgattaccagcctgggcgcaatcgtgtcctgctacggcaagacgaagtgcaccgccagcaacaagaaccgggggatcatcaagaccttctccaacggctgcgactatgtcagcaacaagggggtggacaccgtgagcgtcggaaacacgctctactgcgtgaacaagcaagagggcaagtccttatacgtgaagggggagcccatcatcaacttctacgaccccctggtcttcccgagcgacgagttcgacgccagcataagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccttgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16459 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut4 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccggctccgggagcgcgatctgctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactcccggaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaaccgcggcatcatcaagaccttctccaacgggtgcgactacgtcagcaacaagggcgtggacaccgtgtccgtcggcaacaccctgtactgcgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16460 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut4 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagctcctgatgcagagcaccccggccgccgggtccggcagcgccatctgctccgggatcgcggtgtgcaaggtgctgcacctcgagggcgaggtcaacaagatcaagaacgccctgctgagcaccaacaaggccgtggtgtccctcagcaacggcgtctccgtgctgaccttcaaggtgctggacctcaagaactacatcgacaagcagctgctgcccatcctcaacaagcagagctgctccatcagcaacatcgagacggtcatcgagttccagcagaagaacaaccggctgctggagatcacccgcgagttctccgtgaacgccggggtgaccacccccgtcagcacgtacatgctcaccaacagcgagctgctgtccctcatcaacgacatgcccatcaccaacgaccagaagaagctgatgagcaacaacgtgcagatcgtgcggcagcagtcctacagcatcatgtgcatcatcaaggaggaggtcctggcctacgtggtgcagctcccgctgtacggcgtcatcgacaccccctgctggaagctgcacacgagccccctctgcaccaccaacaccaaggaggggtccaacatctgcctgacgcgcaccgaccggggctggtactgcgacaacgcggggtccgtgagcttcttcccccaggccgagacctgcaaggtgcagtccaaccgcgtcttctgcgacaccatgaacagccggacgctcccgtccgaggtgaacctgtgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaaccgggggatcatcaagaccttctccaacggctgcgactacgtcagcaacaagggggtggacaccgtgagcgtcggcaacacgctctactgcgtgaacaagcaggagggcaagtccctgtacgtgaagggggagcccatcatcaacttctacgaccccctggtcttcccgagcgacgagttcgacgcctccatcagccaggtgaacgagaagatcaaccagtccctcgcgttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16461 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut4 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccgccggctccggctccgccatctgctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16462 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut4 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagcttctgatgcagtcgacccctgccgctggttcaggcagcgcaatatgtagtgggatcgccgtgtgcaaggtcttgcacctcgagggagaagtgaacaaaattaagaatgctctgctgtccacaaacaaagccgttgtgtctctcagcaatggcgtctccgtgttaacgttcaaggtactggaccttaagaactacatcgataaacaattgctgccaattctaaataagcagtcatgtagtatcagcaacatagagactgttattgaatttcagcagaaaaataacaggctcctggagatcacccgggagttctctgtgaatgcgggtgtcacaactccggtgtccacctatatgcttacaaactcagaactgttgagcctcattaacgacatgcccatcaccaatgatcaaaagaaactgatgagtaacaatgtgcagatcgtccgccagcagtcttactccattatgtgcataatcaaggaggaagttttagcatatgtggtacaactgcctctctacggggtgattgacacgccatgttggaaacttcatactagccccctgtgcacaaccaacactaaggagggatcgaatatctgtttgacacgaaccgatcgtggctggtactgcgacaacgccggctctgtctcctttttccctcaggctgaaacgtgtaaggtgcagtcaaatagagtgttttgcgataccatgaacagtagaacactgccaagcgaggtgaatctctgcaacatagacattttcaatcccaaatatgattgtaagatcatgacttccaaaaccgacgtctctagctcagtgatcacaagtctgggggccattgtatcctgctacggaaagactaaatgtaccgcaagcaacaagaataggggtatcattaagacattttctaacggctgcgattatgtttcaaataaaggggtggacaccgtcagtgtgggaaacactctttactgtgtcaacaagcaagagggcaaaagcctgtatgtgaagggtgaacctataatcaatttctacgacccattggtttttccgtccgatgagttcgacgcttctatttcgcaggttaacgagaaaatcaatcagagcctcgcctttatccggaagtccgatgaactgttacacaacgtaaatgtcgggaagtcaacgacaaacattatgataaccactatcattatcgtgattatcgttatactgctactcctgatcgcggtgggacttttcttgtattgcaaagcccgcagtacccccgtcacactgtctaaggaccagctcagcggcattaataacatcgcattctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
